United States Patent 10,400,015 (RECOMBINANT HIV-1 ENVELOPE PROTEINS AND THEIR USE) - sequence listing, part 2

SEQ ID NO: 1963 - protein, 650 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1964 - protein, 686 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1965 - protein, 664 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1966 - protein, 676 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1967 - protein, 686 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1968 - protein, 680 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1969 - protein, 688 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1970 - protein, 680 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1971 - protein, 675 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1972 - protein, 677 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1973 - protein, 675 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1974 - protein, 694 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1975 - protein, 665 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1976 - protein, 677 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1977 - protein, 685 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1978 - protein, 676 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1979 - protein, 680 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1980 - protein, 667 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1981 - protein, 682 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1982 - protein, 696 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1983 - protein, 662 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1984 - protein, 698 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1985 - protein, 676 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1986 - protein, 783 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1987 - protein, 793 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1988 - protein, 787 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1989 - protein, 795 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKAMYAPPIKGQISCSSNITGLLLTRDGGNNNSSGPETFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1990 - protein, 787 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1991 - protein, 782 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1992 - protein, 784 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1993 - protein, 782 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1994 - protein, 801 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1995 - protein, 772 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1996 - protein, 784 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1997 - protein, 792 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1998 - protein, 783 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1999 - protein, 787 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 2000 - protein, 774 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 2001 - protein, 789 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 2002 - protein, 803 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 2003 - protein, 769 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 2004 - protein, 805 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 2005 - protein, 783 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 2006 - protein, 834 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2007 - protein, 832 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2008 - protein, 842 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2009 - protein, 855 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2010 - protein, 833 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2011 - protein, 819 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2012 - protein, 822 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2013 - protein, 833 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2014 - protein, 833 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2015 - protein, 853 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2016 - protein, 837 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2017 - protein, 824 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2018 - protein, 851 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 2019 - protein, 669 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLPMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2020 - protein, 667 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQPIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2021 - protein, 677 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQPMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2022 - protein, 690 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRPMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2023 - protein, 668 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRPMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2024 - protein, 654 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRPMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2025 - protein, 689 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQPMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2026 - protein, 657 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQPMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2027 - protein, 679 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQPIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2028 - protein, 668 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRPMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2029 - protein, 668 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRPMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2030 - protein, 688 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRPMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2031 - protein, 672 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRPMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2032 - protein, 681 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLPMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2033 - protein, 671 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRPMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2034 - protein, 666 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRPMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2035 - protein, 686 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQPMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2036 - protein, 702 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRPMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2037 - protein, 684 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRPMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2038 - protein, 664 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRPMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2039 - protein, 669 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVYSLFEKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2040 - protein, 667 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVYSLFERIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2041 - protein, 677 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVYSLFEKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2042 - protein, 690 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQYSLFEKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2043 - protein, 667 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNEYSLFELDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2044 - protein, 654 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALYSLFEIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2045 - protein, 689 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVYSLFEKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2046 - protein, 657 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALYSLFEIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2047 - protein, 679 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVYSLFERIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2048 - protein, 668 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYSLFEKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2049 - protein, 668 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVYSLFERLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2050 - protein, 688 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYSLFESLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2051 - protein, 672 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYYSLFELDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2052 - protein, 681 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVYSLFEKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2053 - protein, 671 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGYSLFETLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2054 - protein, 666 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYSLFEKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2055 - protein, 686 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVYSLFEKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2056 - protein, 702 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQYSLFEKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2057 - protein, 684 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYSLFERLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2058 - protein, 664 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGYSLFETLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2059 - protein, 669 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVESLFEKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2060 - protein, 667 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVESLFERIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2061 - protein, 677 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVESLFEKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2062 - protein, 690 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQESLFEKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2063 - protein, 668 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNEESLFEKLDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2064 - protein, 654 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVESLFEKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2065 - protein, 689 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVESLFEKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2066 - protein, 657 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVESLFEKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2067 - protein, 679 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVESLFERIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2068 - protein, 668 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVESLFEKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2069 - protein, 668 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVESLFERLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2070 - protein, 688 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKESLFESLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2071 - protein, 672 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVESLFERLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2072 - protein, 681 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVESLFEKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2073 - protein, 671 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGESLFETLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2074 - protein, 666 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVESLFEKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2075 - protein, 687 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVESLFEYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2076 - protein, 702 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQESLFEKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2077 - protein, 684 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVESLFERLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2078 - protein, 664 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGESLFETLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2079 - protein, 669 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVESLFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2080 - protein, 667 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVESLFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2081 - protein, 677 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVESLFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2082 - protein, 690 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQESLFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2083 - protein, 668 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNEESLFYKLDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2084 - protein, 654 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVESLFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2085 - protein, 689 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVESLFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2086 - protein, 657 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVESLFYKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2087 - protein, 679 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVESLFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2088 - protein, 668 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVESLFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2089 - protein, 668 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVESLFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2090 - protein, 688 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKESLFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2091 - protein, 672 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVESLFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2092 - protein, 681 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVESLFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2093 - protein, 671 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGESLFYTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2094 - protein, 666 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVESLFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2095 - protein, 686 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVESLFYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2096 - protein, 702 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQESLFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2097 - protein, 684 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVESLFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 2098 - protein, 664 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGESLFYTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 2099 - protein, 131 aa, Homo Sapiens
QGQLVQSGAELKKPGASVKISCKTSGYRFNFYHINWIRQTAGRGPEWMGWISPYSGDKNLAPAFQDRVIMTTDTEVPVTSFTSTGAAYMEIRNLKFDDTGTYFCAKGLLRDGSSTWLPYLWGQGTLLTVSS

SEQ ID NO: 2100 - protein, 110 aa, Homo Sapiens
QSVLTQSASVSGSLGQSVTISCTGPNSVCCSHKSISWYQWPPGRAPTLIIYEDNERAPGISPRFSGYKSYWSAYLTISDLRPEDETTYYCCSYTHNSGCVFGTGTKVSVL

SEQ ID NO: 2101 - protein, 270 aa, Escherichia coli
LMTKHTLEQLAADLRRAAEQGEAIAPLRDLIGIDNAEAAYAIQHINVQHDVAQGRRVVGRKVGLTHPKVQQQLGVDQPDFGTLFADMCYGDNEIIPFSRVLQPRIEAEIALVLNRDLPATDITFDELYNAIEWVLPALEVVGSRIRDWSIQFVDTVADNASCGVYVIGGPAQRPAGLDLKNCAMKMTRNNEEVSSGRGSECLGHPLNAAVWLARKMASLGEPLRTGDIILTGALGPMVAVNAGDRFEAHIEGIGSVAATFSSAAPKGSLS

SEQ ID NO: 2102 - protein, 253 aa, cocksfoot mottle virus
MVRKGAAAKAPQQPKPKAQQQPGGRRRRRGRSMEPVSRPLNPPAAVGSTLKAGRGRTAGVSDWFDTGMITSYLGGFQRTAGTTDSQVFIVSPAALDRVGTIAKAYALWRPKHWEIVYLPRCSTQTDGSIEMGFLLDYADSVPTNTRTMASSTSFTTSNVWGGGDGSSLLHTSMKSMGNAVTSALPCDEFSNKWFKLSWSTPEESENAHLTDTYVPARFVVRSDFPVVTADQPGHLWLRSRILLKGSVSPSTNL

SEQ ID NO: 2103 - protein, 238 aa, Rice yellow mottle virus
ARKGKKTNSNQGQQGKRKSRRPRGRSAEPQLQRAPVAQASRISGTVPGPLSSNTWPLHSVEFLADFKRSSTSADATTYDCVPFNLPRVWSLARCYSMWKPTRWDVVYLPEVSATVAGSIEMCFLYDYADTIPRYTGKMSRTAGFVTSSVWYGAEGCHLLSGGSARNAVVASMDCSRVGWKRVTSSIPSSVDPNVVNTILPARLAVRSSIKPTVSDTPGKLYVIASMVLRDPVDPTLNT

SEQ ID NO: 2104 - protein, 266 aa, sesbania mosaic virus
AKRLSIQQLAKAIANTLETPPQPKAGRRRNRRRQRSAVQQLPPIQAGISMAPSAQGAMVRIRNPAVSSSRGAITVLHCELTAEIGVTDSIVVSSELVMPYTVGTWLRGVADNWSKYSWLSVRYTYIPSCPSSTAGSIHMGFQYDMADTVPVSVNKLSNLRGYVSGQVWSGSAGLCFINNSRCSDTSTAISTTLDVSELGKKWYPYKTSADYATAVGVDVNIATDLVPARLVIALLDGSSSTAVAAGRIYDTYTIQMIEPTASALNL

SEQ ID NO: 2105 - protein, 387 aa, tomato bushy stunt virus
AMTTRNNNNVLAVSKKQLGVLAASAAVGALRNYIGESSPALLQSAVGLGKKALNKVRNRRKQGNQQIITHVGGVGGSIMAPVAVSRQLVGSKPKFTGRTSGGVTVTSHREYLTQVNNSSGFVVNGGIVGNSLQLNPSNGTLFSWLPALASNFDQYSFNSVVLDYVPLCGTTEVGRVALYFDKDSQDPEPADRVELANFGVLKETAPWAEAMLRIPTDKVKRYCNDSATVDQKLIDLGQLGIATYGGAGADAVGELFLARSVTLYFPQPTNTLLSSKRLDLTGSLADATGPGYLVLTRTPTVLTHTFRATGTFNLSGGLRCLTSLTLGATGAVVINDILAIDNVGTASDYFLNCTVSSLPATVTFTVSGVAAGILLVGRARANVVNLL

SEQ ID NO: 2106 - protein, 129 aa, bacteriophage MS2
ASNFTQFVLVDNGGTGDVTVAPSNFANGVAEWISSNSRSQAYKVACSVRQSSAQNRKYTIKVEVPKVATQTVGGVELPVAAWRSYLNMELTIPIFATNSDCELIVKAMQGLLKDGNPIPSAIAANSGIY

SEQ ID NO: 2107 - protein, 129 aa, bacteriophage fr
ASNFEEFVLVDNGGTGDVKVAPSNFANGVAEWISSNSRSQAYKVTCSVRQSSANNRKYTVKVEVPKVATQVQGGVELPVAAWRSYMNMELTIPVFATNDDCALIVKALQGTFKTGNPIATAIAANSGIY

SEQ ID NO: 2108 - protein, 122 aa, bacteriophage phi-C
ALGDTLTITLGGSGGTAKVLRKINQDGYTSEYYLPETSSSFRAKVRHTKESVKPNQVQYERHNVEFTETVYASGSTPEFVRQAYVVIRHKVGDVSATVSDLGEALSFYLNEALYGKLIGWES

SEQ ID NO: 2109 - protein, 282 aa, bacteriophage HK97
SLGSDADSAGSLIQPMQIPGIIMPGLRRLTIRDLLAQGRTSSNALEYVREEVFTNNADVVAEKALKPESDITFSKQTANVKTIAHWVQASRQVMDDAPMLQSYINNRLMYGLALKEEGQLLNGDGTGDNLEGLNKVATAYDTSLNATGDTRADIIAHAIYQVTESEFSASGIVLNPRDWHNIALLKDNEGRYIFGGPQAFTSNIMWGLPVVPTKAQAAGTFTVGGFDMASQVWDRMDATVEVSREDRDNFVKNMLTILCEERLALAHYRPTAIIKGTFSSGS

SEQ ID NO: 2110 - protein, 129 aa, bacteriophage GA
ATLRSFVLVDNGGTGNVTVVPVSNANGVAEWLSNNSRSQAYRVTASYRASGADKRKYTIKLEVPKIVTQVVNGVELPVSAWKAYASIDLTIPIFAATDDVTVISKSLAGLFKVGNPIAEAISSQSGFYA

SEQ ID NO: 2111 - protein, 131 aa, bacteriophage PRR1
AQLQNLVLKDREATPNDHTFVPRDIRDNVGEVVESTGVPIGESRFTISLRKTSNGRYKSTLKLVVPVVQSQTVNGIVTPVVVRTSYVTVDFDYDARSTTKERNNFVGMIADALKADKMLVHDTIVNLQGVY

SEQ ID NO: 2112 - protein, 127 aa, bacteriophage PP7
SKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGR

SEQ ID NO: 2113 - protein, 132 aa, bacteriophage Q-beta
AKLETVTLGNIGKDGKQTLVLNPRGVNPTNGVASLSQAGAVPALEKRVTVSVSQPSRNRKNYKVQVKIQNPTACTANGSCDPSVTRQAYADVTFSFTQYSTDEERAFVRTELAALLASPLLIDAIDQLNPAY

SEQ ID NO: 2114 - protein, 855 aa, human immunodeficiency virus
MRVMGIQRNYPPLWRWGTMIFWMMMLCSAEKLWVTVYYGVPVWREADTTLFCASDAKGYDTEAHNVWATHACVPTDPRPQEMYLENVTENFNMWKNSMVEQMHTDIISLWDESLKPCVKLTPLCVTLDCQAFNSSSHTNSSIAMQEMKNCSFNVTTELRDKKKKEYSFFYKTDIEQINKNGRQYRLINCNTSAITQACPKVSFEPIPIHFCAPAGFAILKCNEKHFNGKGPCKNVSTVQCTHGIKPVVSTQLLLNGSLAEEEVVIRVENTIDNAKTIIVQLAKPVKINCTRPNNNTRKSIRIGPGQTFYATGDIIGNIRKAYCNVSKREWNNTLQQVAAQLSKSFNNTKIVFEKHSGGDLEVITHSFVCGGEFFYCNTSGLFNSTWTNSTWTNSTTGSNGTESNDTITLQCEIKQFINMWQRVGRAMYAPPIPGVIRCESDITGLLLTRDGPNSTQNETFRPGGGDMRDNWRSELYKYKVVQIEPLGVAPTHAKRRVVEREKRAVGLGAVFFGFLGAAGSTMGAASITLTVQARQLLSGIVQQQSNLLKAIEAQQQLLRLTVWGIKQLQARVLALERYLKDQQLLGIWGCSGKLICTTTVPWNSSWSNKNYTDIWDNMTWLQWDREISNYTDEIYRLIEQSQNQQEKNEQDLLALDKWASLWNWFDITNWLWYIKIFIMIVGGLIGLRIIFTVLNVINRVRQGYSPLSFQTLTHHQREPDRPERIEEGGGEQDRDRSVRLVSGFLALAWDDLRSLCLFSFHRLRDLVLIAARGVELLGHSSLKGLRLGWEALKLLGNLLSYWGQELKNSAINLLDAVAIAVANWTDRVIKIGQRAGRAILNIPIRIRQGLERALL

SEQ ID NO: 2115 - protein, 847 aa, human immunodeficiency virus
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 2116 - protein, 829 aa, artificial sequence
  Recombinant HIV protein
AEKLWVTVYYGVPVWREADTTLFCASDAKGYDTEAHNVWATHACVPTDPRPQEMYLENVTENFNMWKNSMVEQMHTDIISLWDESLKPCVKLTPLCVTLDCQAFNSSSHTNSSIAMQEMKNCSFNVTTELRDKKKKEYSFFYKTDIEQINKNGRQYRLINCNTSACTQACPKVSFEPIPIHFCAPAGFAILKCNEKHFNGKGPCKNVSTVQCTHGIKPVVSTQLLLNGSLAEEEVVIRVENTIDNAKTIIVQLAKPVKINCTRPNNNTRKSIRIGPGQTFYATGDIIGNIRKAYCNVSKREWNNTLQQVAAQLSKSFNNTKIVFEKHSGGDLEVITHSFVCGGEFFYCNTSGLFNSTWTNSTWTNSTTGSNGTESNDTITLQCEIKQFINMWQRVGRCMYAPPIPGVIRCESDITGLLLTRDGPNSTQNETFRPGGGDMRDNWRSELYKYKVVQIEPLGVAPTHCKRRVVERRRRRRAVGLGAVFFGFLGAAGSTMGAASITLTVQARQLLSGIVQQQSNLLKAPEAQQQLLRLTVWGIKQLQARVLALERYLKDQQLLGIWGCSGKLICCTTVPWNSSWSNKNYTDIWDNMTWLQWDREISNYTDEIYRLIEQSQNQQEKNEQDLLALDKWASLWNWFDITNWLWYIKIFIMIVGGLIGLRIIFTVLNVINRVRQGYSPLSFQTLTHHQREPDRPERIEEGGGEQDRDRSVRLVSGFLALAWDDLRSLCLFSFHRLRDLVLIAARGVELLGHSSLKGLRLGWEALKLLGNLLSYWGQELKNSAINLLDAVAIAVANWTDRVIKIGQRAGRAILNIPIRIRQGLERALL

SEQ ID NO: 2117 - protein, 643 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2118 - protein, 458 aa, homo sapiens
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 2119 - DNA, 1908 bp, artificial sequence
  Recombinant HIV protein
gccgaaaacctgtgggtcaccgtgtattatggagtgcccgtctggaaagatgctgaaactaccctgttctgtgcctctgatgctaaggcctacgagaccgaaaagcacaatgtctgggctactcatgcatgcgtgcccaccgacccaaacccccaggagatccacctggaaaatgtgaccgaggaattcaacatgtggaaaaacaatatggtggagcagatgcatacagacatcattagcctgtgggatcagtccctgaagccctgcgtcaaactgactcctctgtgcgtgaccctgcagtgtaccaatgtcacaaacaatatcaccgacgatatgaggggcgagctgaagaattgtagcttcaacatgaccacagaactgagagacaagaaacagaaagtgtactccctgttttataggctggatgtggtccagatcaatgagaaccaggggaatcggagcaacaattccaacaaggaatacagactgatcaattgcaacacttccgcctgtacccaggcttgtcctaaagtgtcttttgagcctatcccaattcattattgcgccccagctggcttcgccatcctgaagtgtaaagataagaagttcaacggaactggcccctgcccttccgtgtctacagtccagtgtactcacgggattaagcctgtggtctctacacagctgctgctgaatggaagtctggctgaggaagaagtgatgatccggagcgagaacattaccaacaatgccaagaatatcctggtccagttcaacacaccagtgcagattaattgcacaagacccaacaataacactcgaaaatctatccggattgggccaggacaggccttttacgctacaggggacatcattggagatatcagacaggctcactgtaatgtgagtaaggcaacctggaacgagacactgggcaaggtggtcaaacagctgaggaaacatttcgggaataacaccatcattcgctttgccaatagctccggaggggacctggaggtcactacccactccttcaactgcggaggcgaattcttttactgtaacacatctggcctgtttaatagtacatggatctctaacactagtgtgcagggcagtaattcaactgggtcaaacgatagcatcaccctgccatgccgaattaagcagatcattaatatgtggcagcggatcggccagtgcatgtatgccccccctatccagggggtcattcgctgcgtgagcaatatcaccggactgattctgacacgagacgggggcagcaccaactctacaactgaaacattccggcccggcgggggagacatgagagataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggctctggattgatag

SEQ ID NO: 2120 - DNA, 1902 bp, artificial sequence
  Recombinant HIV protein
gccgaaaacctgtgggtcaccgtgtattatggagtgcccgtctggaaagatgctgaaactaccctgttctgtgcctctgatgctaaggcctacgagaccgaaaagcacaatgtctgggctactcatgcatgcgtgcccaccgacccaaacccccaggagatccacctggaaaatgtgaccgaggaattcaacatgtggaaaaacaatatggtggagcagatgcatacagacatcattagcctgtgggatcagtccctgaagccctgcgtcaaactgactcctctgtgcgtgaccctgcagtgtaccaatgtcacaaacaatatcaccgacgatatgaggggcgagctgaagaattgtagcttcaacatgaccacagaactgagagacaagaaacagaaagtgtactccctgttttataggctggatgtggtccagatcaatgagaaccaggggaatcggagcaacaattccaacaaggaatacagactgatcaattgcaacacttccgccattacccaggcttgtcctaaagtgtcttttgagcctatcccaattcattattgcgccccagctggcttcgccatcctgaagtgtaaagataagaagttcaacggaactggcccctgcccttccgtgtctacagtccagtgtactcacgggattaagcctgtggtctctacacagctgctgctgaatggaagtctggctgaggaagaagtgatgatccggagcgagaacattaccaacaatgccaagaatatcctggtccagttcaacacaccagtgcagattaattgcacaagacccaacaataacactcgaaaatctatccggattgggccaggacaggccttttacgctacaggggacatcattggagatatcagacaggctcactgtactgtgagtaaggcaacctggaacgagacactgggcaaggtggtcaaacagctgaggaaacatttcgggaataacaccatcattcgctttgccaatagctccggaggggacctggaggtcactacccactccttcaactgcggaggcgaattcttttactgtaacacatctggcctgtttaatagtacatggatctctaacactagtgtgcagggcagtaattcaactgggtcaaacgatagcatcaccctgccatgccgaattaagcagatcattaatatgtggcagcggatcggccaggcaatgtatgccccccctatccagggggtcattcgctgcgtgagcaatatcaccggactgattctgacacgagacgggggcagcaccaactctacaactgaaacattccggcccggcgggggagacatgagagataactggaggtccgagctgtacaagtataaagtggtcaagatcgaacctctgggagtggcaccaaccagatgcaagcgaagagtggtcggacgaaggaggaggaggcgagcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggat

SEQ ID NO: 2121 - protein, 632 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCSDAKVNINATYNGTREEIKNCSFNATTELRDKKKKEYALFYRLDIVPLNKEGNNNSEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2122 - protein, 629 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2123 - protein, 631 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2124 - protein, 650 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2125 - protein, 626 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2126 - protein, 627 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2127 - protein, 643 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNANLTKANLTNVNNRTNVSNIIGNITDEVRNCSFNMTTELRDKKQKVHALFYKLDIVPIEDNNDNSKYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2128 - protein, 634 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNVTISSTNGSTANVTMREEMKNCSFNTTTVIRDKIQKEYALFYKLDIVPIEGKNTNTGYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2129 - protein, 629 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCQAFNSSSHTNSSIAMQEMKNCSFNVTTELRDKKKKEYSFFYKTDIEQINKNGRQYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2130 - protein, 632 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCSDAKVTINAIYNGTREEIKNCSFNTTTELRDKKKKQYALFYRLDIVPLNKEGNNNSEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2131 - protein, 630 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCSDAKVNATYKGTREEIKNCSFNATTELRDKKRREYALFYRLDIVPLSGEGNNNSEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2132 - protein, 632 aa, artificial sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCSDAKVNVNDTYNGTREEIKNCSFNATTELRDKKRREYALFYRLDIVPLSGEGNNNSEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGRLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2133 - protein, 636 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLNCSDAKVNINATYNGTREEIKNCSFNATTELRDKKKKEYALFYRLDIVPLNKEGNNNSEYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2134 - protein, 633 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLECRNITGVNISEGKEEIKNCSFNITTELRDKRKKVYSLFYRLDVVQIDEGDKNSTQYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2135 - protein, 635 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLNCINANVTNSSMTNSSMMEGEIKNCSYNMTTELRDKKRKVFSLFYKLDVVPMNENNSEYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2136 - protein, 654 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2137 - protein, 630 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCSTYNNTHNISKEMKICSFNMTTELRDKKRKVNVLFYKLDLVPLTNSSNTTNYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2138 - protein, 631 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLHCTNVTSVNTTGDREGLKNCSFNMTTELRDKRQKVYSLFYRLDIVPINENQGSEYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2139 - protein, 647 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLHCTNANLTKANLTNVNNRTNVSNIIGNITDEVRNCSFNMTTELRDKKQKVHALFYKLDIVPIEDNNDNSKYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2140 - protein, 638 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLHCTNVTISSTNGSTANVTMREEMKNCSFNTTTVIRDKIQKEYALFYKLDIVPIEGKNTNTGYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2141 - protein, 633 aa, artificial sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCQAFNSSSHTNSSIAMQEMKNCSFNVTTELRDKKKKEYSFFYKTDIEQINKNGRQYRLINCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 2142 - protein, 668 aa, human immunodeficiency virus
MDAMKRGLCCVLLLCGAVFVSPSASVGNLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLSDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTTNNTEIFRPGGGDMRDNWRSELYKYKVVEIKPLGVAPTDAKSSVVESNKSAVGIGAVFLGFLGAAGSTMGAASITLTVQARQLLSGIVQQQSNLLRAIEAQQHMLQLTVWGIKQLQTRVLAIERYLKDQQLLGLWGCSGKLICTTAVPWNISWSNKSKEEIWENMTWMQWDREINNYTNTIYRLLEESQNQQENNEKDLLALDSWNNLWNWFNITNWLWYIK

SEQ ID NO: 2143 - DNA, 2007 bp, human immunodeficiency virus
atggacgccatgaagagagggctgtgctgcgtgctgctgctgtgcggagcagtgttcgtcagcccttccgcctctgtgggcaacctgtgggtgaccgtctactatggggtgccagtctggaaagaggctaagaccacactgttttgcgcatccgacgcaaaagcctacgagaaggaagtgcacaacgtctgggcaactcatgcctgcgtgcccaccgatccaaacccccaggaggtggtcctggaaaatgtgacagagaatttcaacatgtggaagaatgacatggtggatcagatgcaggaggacgtgatttccatctgggatcagtctctgaaaccctgcgtgaagctgacccctctgtgcgtcacactgaactgtactaatgtgaacgtcaccagtaattcaacaaatgtgaacagctcctctacagataacactaccctgggcgagatcaaaaattgtagcttcgacattacaactgaaatcagggataaaactcgcaaggagtacgccctgttttatagactggacattgtgccactggataacagttcaaatcccaacagctccaatacctataggctgatcaattgcaacacctccacactgactcaggcttgtcccaaggtgacattcgaccctattccaatccactactgcgctcctgcaggctatgccatcctgaaatgtaacaataagacctttaacggcaaagggccatgcaacaatgtgagcactgtccagtgtacccacggcatcaagcccgtggtctcaacacagctgctgctgaacgggagcctggcagaggaagagattgtgatcagatcaaaaaacctgagcgataatgccaagatcattatcgtgcagctgaataagagtgtggagatcgtctgcacacgacctaacaataacactcggagatcaattaggatcggaccaggccagacattctacgccactgacattatcggagatattcggcaggcttattgtaacatcagtggcagaaattggtcagaagccgtgaaccaggtcaagaaaaagctgaaagagcacttcccccataagaatattagctttcagtctagttcaggcggggacctggaaatcaccacacactccttcaactgcggaggcgagttcttttactgtaatacatccggcctgtttaacgataccatttctaatgccacaatcatgctgccttgccggatcaagcagattatcaacatgtggcaggaagtgggaaaggctatctatgcaccccccatcaagggcaatatcacctgtaagagtgacattacagggctgctgctgctgagagatgggggaaacactaccaataacaccgagattttccggcctggcgggggagacatgcgagataattggcggtctgaactgtacaaatataaggtggtcgagatcaagcctctgggcgtggcaccaactgacgccaaaagcagcgtggtcgagagcaacaagagcgctgtggggatcggagcagtcttcctgggctttctgggagcagctggcagcacaatgggcgcagcctccatcaccctgacagtgcaggcccgccagctgctgtctggaattgtccagcagcagagtaatctgctgcgggccatcgaagctcagcagcacatgctgcagctgacagtgtggggcattaagcagctgcagactcgcgtcctggctatcgagcgatacctgaaagaccagcagctgctgggactgtggggatgctccggaaagctgatttgtacaactgccgtgccctggaacatcagctggtccaacaagtctaaggaagagatttgggaaaacatgacctggatgcagtgggatcgcgagattaataactacactaacaccatctatcggctgctggaagagtctcagaatcagcaggagaataacgaaaaagacctgctggccctggatagttggaataacctgtggaattggttcaacattacaaattggctgtggtacatcaagtag

SEQ ID NO: 2144 - protein, 668 aa, human immunodeficiency virus
MDAMKRGLCCVLLLCGAVFVSPSASVGNLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKDLSDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGDTTDNTEIFRPGGGDMRDNWRSELYKYKVVEIKPLGVAPTDAISSVVESNKSAVGIGAVFLGFLGAAGSTMGAASITLTVQARQLLSGIVQQQSNLLRAIEAQQHMLQLTVWGIKQLQTRVLAIERYLKDQQLLGLWGCSGKLICTTAVPWNISWSNKSKEEIWENMTWMQWDREINNYTNTIYRLLEESQNQQENNEKDLLALDSWNNLWNWFNITNWLWYIK

SEQ ID NO: 2145 - protein, 854 aa, human immunodeficiency virus
MRVMGIRKNCQRLWRGGTLFLGILMIFSAAENLWVTVYYGVPVWKEATATLFCASDAKAYETEVHNVWATHACVPTDPNPQEVVLENVTENFNMWKNNMVEQMHEDIISLWDQSLKPCVKLTPLCVTLNCTDYLGNATNTTSSSGGAMEGGEIKNCSFNITTSMRDKMQKEYALFYKLDVVSIDNDNASTNYRLISCNTSVITQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKAMYAPPIKGQIRCSSNITGLLLTRDGGSSTNGTTETFRPGGGDMRDNWRSELYKYKVVKIEPLGLAPTRAKRRVVQREKRAVGIGAVFLGFLGAAGSTMGAASMTLTVQARLLLSGIVQQQNNLLRAIEAQQHLLQLTVWGIKQLQARVLAVERYLKDQQLLGIWGCSGKLICTTAVPWNASWSNKSLDKIWNNMTWMEWEREINNYTGLIYNLIEESQNQQEKNEQELLELDKWASLWNWFDITKWLWYIKIFIMIVGGLVGLRIIFTVLSIVNRVRQGYSPLSFQTHLPAPRGPDRPEGIGEEGGEQDRDRSDRLVTGFLAIFWVDLRSLCLFSYHRLRDLLLIVTRIVELLGRRGWEILKYWWNLLQYWNQELKNSAVSLLNATAIVVAEGTDRVIEVLQRAFRAVLNIPTRIRQGLERALL

SEQ ID NO: 2146 - protein, 619 aa, artificial sequence; identical to SEQ ID NO: 1676
  Recombinant HIV protein

SEQ ID NO: 2147 - protein, 619 aa, artificial sequence; identical to SEQ ID NO: 1677
  Recombinant HIV protein

SEQ ID NO: 2148 - protein, 611 aa, artificial sequence; identical to SEQ ID NO: 1678
  Recombinant HIV protein

SEQ ID NO: 2149 - protein, 611 aa, artificial sequence; identical to SEQ ID NO: 1679
  Recombinant HIV protein

SEQ ID NO: 2150 - protein, 633 aa, artificial sequence; identical to SEQ ID NO: 1680
  Recombinant HIV protein

SEQ ID NO: 2151 - protein, 633 aa, artificial sequence; identical to SEQ ID NO: 1681
  Recombinant HIV protein

SEQ ID NO: 2152 - protein, 633 aa, artificial sequence; identical to SEQ ID NO: 1682
  Recombinant HIV protein

SEQ ID NO: 2153 - protein, 625 aa, artificial sequence; identical to SEQ ID NO: 1683
  Recombinant HIV protein

SEQ ID NO: 2154 - protein, 625 aa, artificial sequence; identical to SEQ ID NO: 1684
  Recombinant HIV protein

SEQ ID NO: 2155 - protein, 625 aa, artificial sequence; identical to SEQ ID NO: 1685
  Recombinant HIV protein

SEQ ID NO: 2156 - protein, 628 aa, artificial sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRNVTGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 2157 - protein, 623 aa, artificial sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRNVTGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 2158 - protein, 634 aa, artificial sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 2159 - protein, 629 aa, artificial sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD
